United States Patent 11,098,302 (IDENTIFICATION OF POLYNUCLEOTIDES ASSOCIATED WITH A SAMPLE) - sequence listing, part 182

SEQ ID NO: 796318 - DNA, 5 bp, Artificial Sequence
  misc_feature: Description of Artificial Sequence: Synthetic Adaptor_v2 oligonucleotide
ggggg

SEQ ID NO: 796319 - DNA, 23 bp, Artificial Sequence
  misc_feature: Description of Artificial Sequence: Synthetic Univ_seq_2 oligonucleotide
aacgcgtgacgagagactgacag

SEQ ID NO: 796320 - DNA, 24 bp, Artificial Sequence
  misc_feature: Description of Artificial Sequence: Synthetic Univ_seq_4 oligonucleotide
ttgttgcgttcctagccgctatag

SEQ ID NO: 796321 - DNA, 24 bp, Artificial Sequence
  misc_feature: Description of Artificial Sequence: Synthetic Univ_seq_5 oligonucleotide
ctctacgaccggtgctcgatttag

SEQ ID NO: 796322 - DNA, 16 bp, Artificial Sequence
  misc_feature: Description of Artificial Sequence: Synthetic Univ_seq_e oligonucleotide
ccgtcggtcggcagtg

SEQ ID NO: 796323 - DNA, 19 bp, Artificial Sequence
  misc_feature: Description of Artificial Sequence: Synthetic IgKC_v4 oligonucleotide
atggcgggaagatgaagac

SEQ ID NO: 796324 - DNA, 22 bp, Artificial Sequence
  misc_feature: Description of Artificial Sequence: Synthetic K_GSP1 oligonucleotide
gtgctgtccttgctgtcctgct

SEQ ID NO: 796325 - DNA, 18 bp, Artificial Sequence
  misc_feature: Description of Artificial Sequence: Synthetic K_GSP1c oligonucleotide
agcaggcacacaacagag

SEQ ID NO: 796326 - DNA, 25 bp, Artificial Sequence
  misc_feature: Description of Artificial Sequence: Synthetic K_GSP1e oligonucleotide
ttgtgtttctcgtagtctgctttgc

SEQ ID NO: 796327 - DNA, 24 bp, Artificial Sequence
  misc_feature: Description of Artificial Sequence: Synthetic K_GSP1f oligonucleotide
tctcccctgttgaagctctttgtg

SEQ ID NO: 796328 - DNA, 18 bp, Artificial Sequence
  misc_feature: Description of Artificial Sequence: Synthetic IgLC_v5 oligonucleotide
ctcccgggtagaagtcac

SEQ ID NO: 796329 - DNA, 22 bp, Artificial Sequence
  misc_feature: Description of Artificial Sequence: Synthetic L_GSP1 oligonucleotide
atctgccttccaggccactgtc

SEQ ID NO: 796330 - DNA, 18 bp, Artificial Sequence
  misc_feature: Description of Artificial Sequence: Synthetic L_GSP1c oligonucleotide
ctcccgggtagaagtcac

SEQ ID NO: 796331 - DNA, 22 bp, Artificial Sequence
  misc_feature: Description of Artificial Sequence: Synthetic L_GSP1d oligonucleotide
acrgctcccgggtagaagtcac

SEQ ID NO: 796332 - DNA, 19 bp, Artificial Sequence
  misc_feature: Description of Artificial Sequence: Synthetic L_GSP1f oligonucleotide
tccacggtgctcccttcat

SEQ ID NO: 796333 - DNA, 20 bp, Artificial Sequence
  misc_feature: Description of Artificial Sequence: Synthetic L_GSP1g oligonucleotide
ggccgcrtacttgttgttgc

SEQ ID NO: 796334 - DNA, 20 bp, Artificial Sequence
  misc_feature: Description of Artificial Sequence: Synthetic L_GSP1h oligonucleotide
gccttccaggccactgtcac

SEQ ID NO: 796335 - DNA, 20 bp, Artificial Sequence
  misc_feature: Description of Artificial Sequence: Synthetic L_GSP1i oligonucleotide
ctgccttccaggccactgtc

SEQ ID NO: 796336 - DNA, 19 bp, Artificial Sequence
  misc_feature: Description of Artificial Sequence: Synthetic L_GSP1j oligonucleotide
ctccacggtgctcccttca

SEQ ID NO: 796337 - DNA, 19 bp, Artificial Sequence
  misc_feature: Description of Artificial Sequence: Synthetic L_GSP1k oligonucleotide
gctcccttcatgcgtgacc

SEQ ID NO: 796338 - DNA, 21 bp, Artificial Sequence
  misc_feature: Description of Artificial Sequence: Synthetic L_GSP1l oligonucleotide
tctgtgggacttccactgctc

SEQ ID NO: 796339 - DNA, 19 bp, Artificial Sequence
  misc_feature: Description of Artificial Sequence: Synthetic L_GSP1m oligonucleotide
ggggccactgtcttctcca

SEQ ID NO: 796340 - DNA, 22 bp, Artificial Sequence
  misc_feature: Description of Artificial Sequence: Synthetic L_GSP1n oligonucleotide
cttctgtgggacttccactgct

SEQ ID NO: 796341 - DNA, 21 bp, Artificial Sequence
  misc_feature: Description of Artificial Sequence: Synthetic L_GSP1o oligonucleotide
atctgccttccaggccactgt

SEQ ID NO: 796342 - DNA, 23 bp, Artificial Sequence
  misc_feature: Description of Artificial Sequence: Synthetic L_GSP1x oligonucleotide
cttytgtgggacttccactgctc

SEQ ID NO: 796343 - DNA, 24 bp, Artificial Sequence
  misc_feature: Description of Artificial Sequence: Synthetic L_GSP1y oligonucleotide
gcttytgtgggacttccactgctc

SEQ ID NO: 796344 - DNA, 19 bp, Artificial Sequence
  misc_feature: Description of Artificial Sequence: Synthetic IgHGC_v13 oligonucleotide
aagtagtccttgaccaggc

SEQ ID NO: 796345 - DNA, 17 bp, Artificial Sequence
  misc_feature: Description of Artificial Sequence: Synthetic G_GSP1c oligonucleotide
ttccacgacaccgtcac

SEQ ID NO: 796346 - DNA, 15 bp, Artificial Sequence
  misc_feature: Description of Artificial Sequence: Synthetic G_GSP1d oligonucleotide
cacgccgctggtcag

SEQ ID NO: 796347 - DNA, 24 bp, Artificial Sequence
  misc_feature: Description of Artificial Sequence: Synthetic G_GSP1g oligonucleotide
gctgctgagggagtagagtcctga

SEQ ID NO: 796348 - DNA, 22 bp, Artificial Sequence
  misc_feature: Description of Artificial Sequence: Synthetic G_GSP1h oligonucleotide
tcttgtccaccttggtgttgct

SEQ ID NO: 796349 - DNA, 18 bp, Artificial Sequence
  misc_feature: Description of Artificial Sequence: Synthetic G_GSP1k oligonucleotide
gctggagggcacggtcac

SEQ ID NO: 796350 - DNA, 23 bp, Artificial Sequence
  misc_feature: Description of Artificial Sequence: Synthetic G_GSP1 oligonucleotide
tcttgtccaccttggtgttgctg

SEQ ID NO: 796351 - DNA, 22 bp, Artificial Sequence
  misc_feature: Description of Artificial Sequence: Synthetic G_GSP1m oligonucleotide
tcttgtccaccttggtgttgct

SEQ ID NO: 796352 - DNA, 22 bp, Artificial Sequence
  misc_feature: Description of Artificial Sequence: Synthetic G_GSP1n oligonucleotide
gactgtaggacagccgggaagg

SEQ ID NO: 796353 - DNA, 21 bp, Artificial Sequence
  misc_feature: Description of Artificial Sequence: Synthetic G_GSP1o oligonucleotide
accacgctgctgagggagtag

SEQ ID NO: 796354 - DNA, 21 bp, Artificial Sequence
  misc_feature: Description of Artificial Sequence: Synthetic G_GSP1p oligonucleotide
ttgtccaccttggtgttgctg

SEQ ID NO: 796355 - DNA, 21 bp, Artificial Sequence
  misc_feature: Description of Artificial Sequence: Synthetic G_GSP1q oligonucleotide
tgagttccacgacaccgtcac

SEQ ID NO: 796356 - DNA, 21 bp, Artificial Sequence
  misc_feature: Description of Artificial Sequence: Synthetic G_GSP1t oligonucleotide
gagttccacgacaccgtcacc

SEQ ID NO: 796357 - DNA, 23 bp, Artificial Sequence
  misc_feature: Description of Artificial Sequence: Synthetic G_GSP1aa oligonucleotide
tcttgtccaccttggtgttgctg

SEQ ID NO: 796358 - DNA, 19 bp, Artificial Sequence
  misc_feature: Description of Artificial Sequence: Synthetic K_GSP2 oligonucleotide
atggcgggaagatgaagac

SEQ ID NO: 796359 - DNA, 19 bp, Artificial Sequence
  misc_feature: Description of Artificial Sequence: Synthetic K_GSP2v2a oligonucleotide
atggcgggaagatgaagac

SEQ ID NO: 796360 - DNA, 18 bp, Artificial Sequence
  misc_feature: Description of Artificial Sequence: Synthetic K_GSP2v2b oligonucleotide
tggcgggaagatgaagac

SEQ ID NO: 796361 - DNA, 21 bp, Artificial Sequence
  misc_feature: Description of Artificial Sequence: Synthetic K_GSP2v2d oligonucleotide
cggaagatgaagacagatggt

SEQ ID NO: 796362 - DNA, 20 bp, Artificial Sequence
  misc_feature: Description of Artificial Sequence: Synthetic K_GSP2v2e oligonucleotide
gcagttccagatttcaactg

SEQ ID NO: 796363 - DNA, 17 bp, Artificial Sequence
  misc_feature: Description of Artificial Sequence: Synthetic K_GSP2v2f oligonucleotide
atggtgcagccacagtt

SEQ ID NO: 796364 - DNA, 23 bp, Artificial Sequence
  misc_feature: Description of Artificial Sequence: Synthetic K_GSP2v2c oligonucleotide
cagatttcaactgctcatcagat

SEQ ID NO: 796365 - DNA, 23 bp, Artificial Sequence
  misc_feature: Description of Artificial Sequence: Synthetic K_GSP2v2g oligonucleotide
tcagatggcgggaagatgaagac

SEQ ID NO: 796366 - DNA, 18 bp, Artificial Sequence
  misc_feature: Description of Artificial Sequence: Synthetic L_GSP2 oligonucleotide
ctcccgggtagaagtcac

SEQ ID NO: 796367 - DNA, 19 bp, Artificial Sequence
  misc_feature: Description of Artificial Sequence: Synthetic L_GSP2v2c oligonucleotide
agggygggaacagagtgac

SEQ ID NO: 796368 - DNA, 18 bp, Artificial Sequence
  misc_feature: Description of Artificial Sequence: Synthetic L_GSP2v2 oligonucleotide
ctcccgggtagaagtcac

SEQ ID NO: 796369 - DNA, 23 bp, Artificial Sequence
  misc_feature: Description of Artificial Sequence: Synthetic L_GSP2v2d oligonucleotide
gaggagggygggaacagagtgac

SEQ ID NO: 796370 - DNA, 16 bp, Artificial Sequence
  misc_feature: Description of Artificial Sequence: Synthetic G_GSP2v2c1 oligonucleotide
gccagggggaagaccg

SEQ ID NO: 796371 - DNA, 20 bp, Artificial Sequence
  misc_feature: Description of Artificial Sequence: Synthetic G_GSP2v2c2 oligonucleotide
ggaagtagtccttgaccagg

SEQ ID NO: 796372 - DNA, 23 bp, Artificial Sequence
  misc_feature: Description of Artificial Sequence: Synthetic G_GSP2b oligonucleotide
ggaagtagtccttgaccaggcag

SEQ ID NO: 796373 - DNA, 19 bp, Artificial Sequence
  misc_feature: Description of Artificial Sequence: Synthetic G_GSP2 oligonucleotide
aagtagtccttgaccaggc

SEQ ID NO: 796374 - DNA, 37 bp, Artificial Sequence
  misc_feature: Description of Artificial Sequence: Synthetic K_NheIa_DHFR oligonucleotide
acgtgctagcagttccagatttcaactgctcatcaga

SEQ ID NO: 796375 - DNA, 39 bp, Artificial Sequence
  misc_feature: Description of Artificial Sequence: Synthetic K_Xho1d_DHFR oligonucleotide
acgtctcgaggatagaagttattcagcaggcacacaaca

SEQ ID NO: 796376 - DNA, 31 bp, Artificial Sequence
  misc_feature: Description of Artificial Sequence: Synthetic L_XhoI_PspXI_DHFR oligonucleotide
acttgctcgagtctgcyttccargcmactgt

SEQ ID NO: 796377 - DNA, 35 bp, Artificial Sequence
  misc_feature: Description of Artificial Sequence: Synthetic L_NheI_DHFR oligonucleotide
agtcgctagccgcrtacttgttgttgctytgtttg

SEQ ID NO: 796378 - DNA, 29 bp, Artificial Sequence
  misc_feature: Description of Artificial Sequence: Synthetic G_EcoRI_DHFR oligonucleotide
agtcgaattccacgacaccgtcaccggtt

SEQ ID NO: 796379 - DNA, 27 bp, Artificial Sequence
  misc_feature: Description of Artificial Sequence: Synthetic G_SacII_DHFR oligonucleotide
attaccgcggggaaggtgtgcacgccg

SEQ ID NO: 796380 - DNA, 32 bp, Artificial Sequence
  misc_feature: Description of Artificial Sequence: Synthetic G_XhoI_PspXI_Lonza oligonucleotide
acgtctcgagggtgccagggggaagaccgatg

SEQ ID NO: 796381 - DNA, 36 bp, Artificial Sequence
  misc_feature: Description of Artificial Sequence: Synthetic Synthetic G_AgeI_Lonza oligonucleotide
actgaccggttcggggaagtagtccttgaccaggca

SEQ ID NO: 796382 - DNA, 26 bp, Artificial Sequence
  misc_feature: Description of Artificial Sequence: Synthetic G_EcoRI_Lonza oligonucleotide
tgcagaattccacgacaccgtcaccg

SEQ ID NO: 796383 - DNA, 29 bp, Artificial Sequence
  misc_feature: Description of Artificial Sequence: Synthetic G_ApaI_Lonza oligonucleotide
tgtagggccctgagttccacgacaccgtc

SEQ ID NO: 796384 - DNA, 42 bp, Artificial Sequence
  misc_feature: Description of Artificial Sequence: Synthetic L_XmaI_Lonza oligonucleotide
tgatcccgggatagaagtcactkatsagrcacacyagtgtgg

SEQ ID NO: 796385 - DNA, 38 bp, Artificial Sequence
  misc_feature: Description of Artificial Sequence: Synthetic L_BstEII_Lonza oligonucleotide
tgcaggtcaccgctcccgggtagaagtcactkatsagr

SEQ ID NO: 796386 - DNA, 32 bp, Artificial Sequence
  misc_feature: Description of Artificial Sequence: Synthetic L_XhoI_PspXI_v2_Lonza oligonucleotide
tgatgctcgagtctgcyttccargcmactgtc

SEQ ID NO: 796387 - DNA, 35 bp, Artificial Sequence
  misc_feature: Description of Artificial Sequence: Synthetic K_XmaI_Lonza oligonucleotide
tagtcccggggatagaagttattcagcaggcacac

SEQ ID NO: 796388 - DNA, 52 bp, Artificial Sequence
  misc_feature: Description of Artificial Sequence: Synthetic 5LIB-LA oligonucleotide
ccatctcatccctgcgtgtctccgactcagcgtatcgcctccctcgcgccat

SEQ ID NO: 796389 - DNA, 52 bp, Artificial Sequence
  misc_feature: Description of Artificial Sequence: Synthetic 5LIB-LB oligonucleotide
cctatcccctgtgtgccttggcagtctcagcgtatcgcctccctcgcgccat

SEQ ID NO: 796390 - DNA, 54 bp, Artificial Sequence
  misc_feature: Description of Artificial Sequence: Synthetic 3LIB-LA oligonucleotide
ccatctcatccctgcgtgtctccgactcagctatgcgccttgccagcccgctca

SEQ ID NO: 796391 - DNA, 54 bp, Artificial Sequence
  misc_feature: Description of Artificial Sequence: Synthetic 3LIB-LB oligonucleotide
cctatcccctgtgtgccttggcagtctcagctatgcgccttgccagcccgctca

SEQ ID NO: 796392 - DNA, 22 bp, Artificial Sequence
  misc_feature: Description of Artificial Sequence: Synthetic mu_GSP1 oligonucleotide
ctctcaggactgatgggaagcc

SEQ ID NO: 796393 - DNA, 48 bp, Artificial Sequence
  misc_feature: Description of Artificial Sequence: Synthetic mu_GSP2 oligonucleotide
ctatgcgccttgccagcccgctcaggggaattctcacaggagacgagg

SEQ ID NO: 796394 - DNA, 23 bp, Artificial Sequence
  misc_feature: Description of Artificial Sequence: Synthetic alpha_GSP1 oligonucleotide
attcgtgtagtgcttcacgtggc

SEQ ID NO: 796395 - DNA, 45 bp, Artificial Sequence
  misc_feature: Description of Artificial Sequence: Synthetic alpha_GSP2 oligonucleotide
ctatgcgccttgccagcccgctcagctcagcgggaagaccttggg

SEQ ID NO: 796396 - DNA, 24 bp, Artificial Sequence
  misc_feature: Description of Artificial Sequence: Synthetic TR_alpha_GSP1a oligonucleotide
cgtttgcacatgcaaagtcagatt

SEQ ID NO: 796397 - DNA, 49 bp, Artificial Sequence
  misc_feature: Description of Artificial Sequence: Synthetic TR_alpha_GSP2b oligonucleotide
ctatgcgccttgccagcccgctcagtcggtgaataggcagacagacttg

SEQ ID NO: 796398 - DNA, 22 bp, Artificial Sequence
  misc_feature: Description of Artificial Sequence: Synthetic TR_beta_GSP1 oligonucleotide
cctatcctgggtccactcgtca

SEQ ID NO: 796399 - DNA, 48 bp, Artificial Sequence
  misc_feature: Description of Artificial Sequence: Synthetic TR_beta_GSP2 oligonucleotide
ctatgcgccttgccagcccgctcagctgcttctgatggctcaaacaca

SEQ ID NO: 796400 - DNA, 24 bp, Artificial Sequence
  misc_feature: Description of Artificial Sequence: Synthetic mouse_mu_GSP1 oligonucleotide
ctgaaccttcaaggatgctcttgg

SEQ ID NO: 796401 - DNA, 51 bp, Artificial Sequence
  misc_feature: Description of Artificial Sequence: Synthetic mouse_mu_GSP2 oligonucleotide
ctatgcgccttgccagcccgctcagggaagacatttgggaaggactgactc

SEQ ID NO: 796402 - DNA, 22 bp, Artificial Sequence
  misc_feature: Description of Artificial Sequence: Synthetic mouse_alpha_GSP1 oligonucleotide
tctccttctgggcactcgacag

SEQ ID NO: 796403 - DNA, 49 bp, Artificial Sequence
  misc_feature: Description of Artificial Sequence: Synthetic mouse_alpha_GSP2 oligonucleotide
ctatgcgccttgccagcccgctcaggggagtgtcagtgggtagatggtg

SEQ ID NO: 796404 - DNA, 22 bp, Artificial Sequence
  misc_feature: Description of Artificial Sequence: Synthetic mo_g12b_GSP1d oligonucleotide
aggggacagtcactgagctgct

SEQ ID NO: 796405 - DNA, 25 bp, Artificial Sequence
  misc_feature: Description of Artificial Sequence: Synthetic mo_g2ac_GSP1d oligonucleotide
tcgaggttacagtcactgagctgct

SEQ ID NO: 796406 - DNA, 25 bp, Artificial Sequence
  misc_feature: Description of Artificial Sequence: Synthetic mo_g3_GSP1d oligonucleotide
tggagggtacagtcaccaagctgct

SEQ ID NO: 796407 - DNA, 47 bp, Artificial Sequence
  misc_feature: Description of Artificial Sequence: Synthetic mo_g12_GSP2d oligonucleotide
ctatgcgccttgccagcccgctcaggggccagtggatagachgatgg

SEQ ID NO: 796408 - DNA, 48 bp, Artificial Sequence
  misc_feature: Description of Artificial Sequence: Synthetic mo_g3_GSP2d oligonucleotide
ctatgcgccttgccagcccgctcaggggaccaagggatagacagatgg

SEQ ID NO: 796409 - DNA, 47 bp, Artificial Sequence
  misc_feature: Description of Artificial Sequence: Synthetic mo_g12_GSP2e oligonucleotide
ctatgcgccttgccagcccgctcagctggacagggatccagagttcc

SEQ ID NO: 796410 - DNA, 47 bp, Artificial Sequence
  misc_feature: Description of Artificial Sequence: Synthetic mo_g3_GSP2e oligonucleotide
ctatgcgccttgccagcccgctcagctggacagggctccatagttcc

SEQ ID NO: 796411 - DNA, 25 bp, Artificial Sequence
  misc_feature: Description of Artificial Sequence: Synthetic mouse_kappa_GSP1 oligonucleotide
gaagttgatgtcttgtgagtggcct

SEQ ID NO: 796412 - DNA, 45 bp, Artificial Sequence
  misc_feature: Description of Artificial Sequence: Synthetic mouse_kappa_GSP2 oligonucleotide
ctatgcgccttgccagcccgctcagtgctcactggatggtgggaa

SEQ ID NO: 796413 - DNA, 27 bp, Artificial Sequence
  misc_feature: Description of Artificial Sequence: Synthetic mouse_lambda_GSP1a oligonucleotide
actcttctccacagtgtccccttcatg

SEQ ID NO: 796414 - DNA, 27 bp, Artificial Sequence
  misc_feature: Description of Artificial Sequence: Synthetic mouse_lambda_GSP1b oligonucleotide
actcttctccacagtgtgaccttcatg

SEQ ID NO: 796415 - DNA, 48 bp, Artificial Sequence
  misc_feature: Description of Artificial Sequence: Synthetic mouse_lambda_GSP2a oligonucleotide
ctatgcgccttgccagcccgctcagagaggaaggtggaaacasggtga

SEQ ID NO: 796416 - DNA, 48 bp, Artificial Sequence
  misc_feature: Description of Artificial Sequence: Synthetic mouse_lambda_GSP2b oligonucleotide
ctatgcgccttgccagcccgctcagaggggaaggtggaaacatggtga

SEQ ID NO: 796417 - DNA, 27 bp, Artificial Sequence
  misc_feature: Description of Artificial Sequence: Synthetic mo_TRA_GSP1b oligonucleotide
ttgaagatatcttggcaggtgaagctt

SEQ ID NO: 796418 - DNA, 47 bp, Artificial Sequence
  misc_feature: Description of Artificial Sequence: Synthetic mouse_TRA_GSP2 oligonucleotide
ctatgcgccttgccagcccgctcagcacagcaggttctgggttctgg

SEQ ID NO: 796419 - DNA, 23 bp, Artificial Sequence
  misc_feature: Description of Artificial Sequence: Synthetic mouse_TRB_GSP1 oligonucleotide
gaaagcccatggaactgcacttg

SEQ ID NO: 796420 - DNA, 50 bp, Artificial Sequence
  misc_feature: Description of Artificial Sequence: Synthetic mouse_TRB_GSP2 oligonucleotide
ctatgcgccttgccagcccgctcaggggtggagtcacatttctcagatcc

SEQ ID NO: 796421 - DNA, 1018 bp, Artificial Sequence
  misc_feature: Description of Artificial Sequence: Synthetic IGHG1-G1m3_constant_region_insert_sequence polynucleotide
aagcttggcgcgccttaattaagccagcacaaaaggccccagtgtgtttcccttggcaccctcgagcaagagtacatctggaggtacagctgccttgggctgtttggtgaaagactatttccccgaaccggttactgtctcttggaattccggggccctcaccagtggtgtccatacctttcccgcggtgcttcagagttccggtttgtattccctgtcaagtgtcgtgacggtaccaagttcaagtctaggcacccagacatatatctgtaacgtcaaccacaagccaagcaacaccaaggttgacaagcgggttgaacctaagtcctgtgacaagacccatacctgccccccatgccccgcacccgagctcctcggagggccttccgtctttcttttccctcccaaacccaaggacactttgatgatctcaagaacaccagaagtcacttgcgtcgtggttgacgtgtctcacgaagatcccgaagtgaagttcaactggtacgtggatggggtagaggttcataacgccaagaccaaaccccgagaggaacagtataactccacctatagggtagtgtccgtgctcaccgtgctccaccaagactggctgaatggcaaggaatacaagtgcaaggtgagtaataaggcactgcctgcacccattgagaagacaatatctaaagcaaagggacagcccagagagccccaggtttatactctgccacctagcagagaggaaatgactaaaaaccaggtcagccttacttgtctcgtaaaaggcttttatccaagcgacatcgctgtggagtgggaatcaaatggccaacctgagaataattataagactacacctcccgtccttgactcagacggttccttcttcctgtatagcaagctcaccgtcgataaaagtcggtggcaacagggaaacgtgttctcatgcagcgtcatgcacgaggccttgcacaatcattacacccagaagtctctgtccctgagccctggaaagtgatca

SEQ ID NO: 796422 - DNA, 346 bp, Artificial Sequence
  misc_feature: Description of Artificial Sequence: Synthetic IGKC-Km3_constant_region_insert_sequence polynucleotide
aagcttaattaaggcgcgccgaacagtggctgctccttccgtgttcatattccccccatccgacgagcagcttaaatctgggactgctagcgtcgtgtgcctgttgaataatttttatccccgggaggctaaggtacagtggaaggtggacaacgccctccaatcagggaattcccaggagtcggtcaccgaacaggacagcaaggactcaacctactctctgtcatccactctcacactcagcaaagccgactatgaaaaacacaaagtgtatgcttgcgaggtgactcatcaagggctctccagtcctgtgactaaatccttcaaccgaggcgaatgctgatca

SEQ ID NO: 796423 - DNA, 346 bp, Artificial Sequence
  misc_feature: Description of Artificial Sequence: Synthetic IGLC-Mcg-Ke-Oz-_constant_region_insert_sequence polynucleotide
aagcttggcgcgccttaattaaggccagcctaaagccgcacccagtgtgaccctgtttcctccctcctctgaagagctccaggcaaacaaagctactctggtgtgtcttattagcgatttctatcccggggcggtgaccgtggcttggaaggccgactcgagcccagtgaaggccggagtggaaactacaaccccttccaaacagtcaaacaataaatacgccgctagcagctatctctctctcaccccagaacagtggaaatcccacaggtcctattcttgccaggtcacacacgaggggtcaaccgttgagaagactgttgccccaacagagtgcagctgatca

SEQ ID NO: 796424 - DNA, 1049 bp, Artificial Sequence
  misc_feature: Description of Artificial Sequence: Synthetic IGHG1-G1m3_constant_region_insert_sequence polynucleotide
taagcttactgataaggcgcgccgcgatcgcgcctccaccaaggacccctctgtcttccccctggcaccctcttcgaagagcacctctggggacacagcagccctgggctgcctggtcaaggactacttccccgaaccagtgacagtgagttggaattcaggcgccctgaccagcggcgtgcacaccttccccgcggtccttcagtcttcaggactctactccctcagcagcgtggtgaccgtgccctccagcagcttggacacccagacctacatctgcaacgtgaatcacaagcccagcaacaccaaggtggacaagagagttgagcccaaatcttgtgacaaaactcacacatgcccaccgtgcccagcacctgaactcctggagggaccgtcagtcttcctcttcctcccaaaacccaaggacaccctcatgatctcccggaccctagaggccacatgcgtggtggtggacgtgagccacgaagaccccgaggtcaagttcaactggtacgtggacggcgtggaggtgcataatgccaagacaaagcctcgggaggagcagtacaacagcacttaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtctacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttttcatgctccgtgatgcatgaggctctgcacaaccactacacacagaagagcctctccctgtccccaggtaaatgataatgtacaactgactgaggatcct

SEQ ID NO: 796425 - DNA, 380 bp, Artificial Sequence
  misc_feature: Description of Artificial Sequence: Synthetic IGKC-Km3_constant_region_insert_sequence polynucleotide
taagcttactgactaggccggccttaattaacgtacggtggctgcaccatctgtcttcatcttccctccatctgatgagcagttgaaatctggaactgctagcgtcgtgtgcctgctgaataacttttatcctcgagaggccaaagtgcagtggaaggtggataacgccctccaatccggtaactcccaggagtccgtcacagagcaggacagcaaggacagcacctacagcctgagcagcaccctgacactgagcaaagcagactacgagaaacacaaagtctacgcctgcgaagtcacccatcagggcctgagctcccccgtcacaaagagcttcaacaggggagagtgttgataaatcgatactgactgaggatcct

SEQ ID NO: 796426 - DNA, 377 bp, Artificial Sequence
  misc_feature: Description of Artificial Sequence: Synthetic IGLC-Mcg-Ke-Oz-_constant_region_insert_sequence polynucleotide
taagcttactgactaggccggccttaattaaggtcagcctaaggctgcccccagcgtcactctgttccctccctcctctgaggagcttcaagccaacaaggccacactggtgtgtctcatcagtgacttctaccccggagccgtgacagtggcttggaaagcagactcgagccccgtcaaggctggagtggagaccaccacaccttccaaacaaagcaacaacaagtacgcagctagcagctaccgcagcctgacccctgagcagtggaagtcccacagaagctactcctgccaggtcacacatgaagggagcaccgtggagaagacagtggcccccacagaatgttcatgataaatcgatactgactgaggatcct

SEQ ID NO: 796427 - DNA, 10 bp, Artificial Sequence
  misc_feature: Description of Artificial Sequence: Synthetic T6.1 oligonucleotide
tatgctagta

SEQ ID NO: 796428 - DNA, 10 bp, Artificial Sequence
  misc_feature: Description of Artificial Sequence: Synthetic T6.2 oligonucleotide
tcacgcgaga

SEQ ID NO: 796429 - DNA, 10 bp, Artificial Sequence
  misc_feature: Description of Artificial Sequence: Synthetic T6.3 oligonucleotide
tcgatagtga

SEQ ID NO: 796430 - DNA, 10 bp, Artificial Sequence
  misc_feature: Description of Artificial Sequence: Synthetic T6.4 oligonucleotide
tcgctgcgta

SEQ ID NO: 796431 - DNA, 10 bp, Artificial Sequence
  misc_feature: Description of Artificial Sequence: Synthetic T6.5 oligonucleotide
tctgacgtca

SEQ ID NO: 796432 - DNA, 10 bp, Artificial Sequence
  misc_feature: Description of Artificial Sequence: Synthetic T6.6 oligonucleotide
tgagtcagta

SEQ ID NO: 796433 - DNA, 10 bp, Artificial Sequence
  misc_feature: Description of Artificial Sequence: Synthetic T6.7 oligonucleotide
tgtagtgtga

SEQ ID NO: 796434 - DNA, 10 bp, Artificial Sequence
  misc_feature: Description of Artificial Sequence: Synthetic T6.8 oligonucleotide
tgtcacacga

SEQ ID NO: 796435 - DNA, 10 bp, Artificial Sequence
  misc_feature: Description of Artificial Sequence: Synthetic T6.9 oligonucleotide
tgtcgtcgca

SEQ ID NO: 796436 - DNA, 10 bp, Artificial Sequence
  misc_feature: Description of Artificial Sequence: Synthetic T6.10 oligonucleotide
acacatacgc

SEQ ID NO: 796437 - DNA, 10 bp, Artificial Sequence
  misc_feature: Description of Artificial Sequence: Synthetic T6.11 oligonucleotide
acagtcgtgc

SEQ ID NO: 796438 - DNA, 10 bp, Artificial Sequence
  misc_feature: Description of Artificial Sequence: Synthetic T6.12 oligonucleotide
acatgacgac

SEQ ID NO: 796439 - DNA, 10 bp, Artificial Sequence
  misc_feature: Description of Artificial Sequence: Synthetic T6.13 oligonucleotide
acgacagctc

SEQ ID NO: 796440 - DNA, 10 bp, Artificial Sequence
  misc_feature: Description of Artificial Sequence: Synthetic T6.14 oligonucleotide
acgtctcatc

SEQ ID NO: 796441 - DNA, 10 bp, Artificial Sequence
  misc_feature: Description of Artificial Sequence: Synthetic T6.15 oligonucleotide
actcatctac

SEQ ID NO: 796442 - DNA, 10 bp, Artificial Sequence
  misc_feature: Description of Artificial Sequence: Synthetic T6.16 oligonucleotide
actcgcgcac

SEQ ID NO: 796443 - DNA, 10 bp, Artificial Sequence
  misc_feature: Description of Artificial Sequence: Synthetic T6.17 oligonucleotide
agagcgtcac

SEQ ID NO: 796444 - DNA, 10 bp, Artificial Sequence
  misc_feature: Description of Artificial Sequence: Synthetic T6.18 oligonucleotide
agcgactagc

SEQ ID NO: 796445 - DNA, 10 bp, Artificial Sequence
  misc_feature: Description of Artificial Sequence: Synthetic T6.19 oligonucleotide
agtagtgatc

SEQ ID NO: 796446 - DNA, 10 bp, Artificial Sequence
  misc_feature: Description of Artificial Sequence: Synthetic T6.20 oligonucleotide
agtgacacac

SEQ ID NO: 796447 - DNA, 10 bp, Artificial Sequence
  misc_feature: Description of Artificial Sequence: Synthetic T6.21 oligonucleotide
agtgtatgtc

SEQ ID NO: 796448 - DNA, 10 bp, Artificial Sequence
  misc_feature: Description of Artificial Sequence: Synthetic T6.22 oligonucleotide
atagatagac

SEQ ID NO: 796449 - DNA, 10 bp, Artificial Sequence
  misc_feature: Description of Artificial Sequence: Synthetic T6.23 oligonucleotide
atatagtcgc

SEQ ID NO: 796450 - DNA, 10 bp, Artificial Sequence
  misc_feature: Description of Artificial Sequence: Synthetic T6.24 oligonucleotide
atctactgac

SEQ ID NO: 796451 - DNA, 10 bp, Artificial Sequence
  misc_feature: Description of Artificial Sequence: Synthetic T6.25 oligonucleotide
cacgtagatc

SEQ ID NO: 796452 - DNA, 10 bp, Artificial Sequence
  misc_feature: Description of Artificial Sequence: Synthetic T6.26 oligonucleotide
cacgtgtcgc

SEQ ID NO: 796453 - DNA, 10 bp, Artificial Sequence
  misc_feature: Description of Artificial Sequence: Synthetic T6.27 oligonucleotide
catactctac

SEQ ID NO: 796454 - DNA, 10 bp, Artificial Sequence
  misc_feature: Description of Artificial Sequence: Synthetic T6.28 oligonucleotide
cgacactatc

SEQ ID NO: 796455 - DNA, 10 bp, Artificial Sequence
  misc_feature: Description of Artificial Sequence: Synthetic T6.29 oligonucleotide
cgagacgcgc

SEQ ID NO: 796456 - DNA, 10 bp, Artificial Sequence
  misc_feature: Description of Artificial Sequence: Synthetic T6.30 oligonucleotide
cgtatgcgac

SEQ ID NO: 796457 - DNA, 10 bp, Artificial Sequence
  misc_feature: Description of Artificial Sequence: Synthetic T6.31 oligonucleotide
cgtcgatctc

SEQ ID NO: 796458 - DNA, 10 bp, Artificial Sequence
  misc_feature: Description of Artificial Sequence: Synthetic Synthetic T6.32 oligonucleotide
ctacgactgc

SEQ ID NO: 796459 - DNA, 10 bp, Artificial Sequence
  misc_feature: Description of Artificial Sequence: Synthetic T6.33 oligonucleotide
ctagtcactc

SEQ ID NO: 796460 - DNA, 10 bp, Artificial Sequence
  misc_feature: Description of Artificial Sequence: Synthetic T6.34 oligonucleotide
ctctacgctc

SEQ ID NO: 796461 - DNA, 10 bp, Artificial Sequence
  misc_feature: Description of Artificial Sequence: Synthetic T6.35 oligonucleotide
ctgtacatac

SEQ ID NO: 796462 - DNA, 10 bp, Artificial Sequence
  misc_feature: Description of Artificial Sequence: Synthetic T6.36 oligonucleotide
tagactgcac

SEQ ID NO: 796463 - DNA, 10 bp, Artificial Sequence
  misc_feature: Description of Artificial Sequence: Synthetic T6.37 oligonucleotide
tagcgcgcgc

SEQ ID NO: 796464 - DNA, 10 bp, Artificial Sequence
  misc_feature: Description of Artificial Sequence: Synthetic T6.38 oligonucleotide
tagctctatc

SEQ ID NO: 796465 - DNA, 10 bp, Artificial Sequence
  misc_feature: Description of Artificial Sequence: Synthetic T6.39 oligonucleotide
tatagacatc

SEQ ID NO: 796466 - DNA, 10 bp, Artificial Sequence
  misc_feature: Description of Artificial Sequence: Synthetic T6.40 oligonucleotide
tatgatacgc

SEQ ID NO: 796467 - DNA, 10 bp, Artificial Sequence
  misc_feature: Description of Artificial Sequence: Synthetic T6.41 oligonucleotide
tcactcatac

SEQ ID NO: 796468 - DNA, 10 bp, Artificial Sequence
  misc_feature: Description of Artificial Sequence: Synthetic T6.42 oligonucleotide
tcatcgagtc

SEQ ID NO: 796469 - DNA, 10 bp, Artificial Sequence
  misc_feature: Description of Artificial Sequence: Synthetic T6.43 oligonucleotide
tcgagctctc

SEQ ID NO: 796470 - DNA, 10 bp, Artificial Sequence
  misc_feature: Description of Artificial Sequence: Synthetic T6.44 oligonucleotide
tcgcagacac

SEQ ID NO: 796471 - DNA, 10 bp, Artificial Sequence
  misc_feature: Description of Artificial Sequence: Synthetic T6.45 oligonucleotide
tctgtctcgc

SEQ ID NO: 796472 - DNA, 10 bp, Artificial Sequence
  misc_feature: Description of Artificial Sequence: Synthetic T6.46 oligonucleotide
tgagtgacgc

SEQ ID NO: 796473 - DNA, 10 bp, Artificial Sequence
  misc_feature: Description of Artificial Sequence: Synthetic T6.47 oligonucleotide
tgatgtgtac

SEQ ID NO: 796474 - DNA, 10 bp, Artificial Sequence
  misc_feature: Description of Artificial Sequence: Synthetic T6.48 oligonucleotide
tgctatagac

SEQ ID NO: 796475 - DNA, 10 bp, Artificial Sequence
  misc_feature: Description of Artificial Sequence: Synthetic T6.49 oligonucleotide
tgctcgctac

SEQ ID NO: 796476 - DNA, 10 bp, Artificial Sequence
  misc_feature: Description of Artificial Sequence: Synthetic T6.50 oligonucleotide
acgtgcagcg

SEQ ID NO: 796477 - DNA, 10 bp, Artificial Sequence
  misc_feature: Description of Artificial Sequence: Synthetic T6.51 oligonucleotide
actcacagag

SEQ ID NO: 796478 - DNA, 10 bp, Artificial Sequence
  misc_feature: Description of Artificial Sequence: Synthetic T6.52 oligonucleotide
agactcagcg

SEQ ID NO: 796479 - DNA, 10 bp, Artificial Sequence
  misc_feature: Description of Artificial Sequence: Synthetic T6.53 oligonucleotide
agagagtgtg

SEQ ID NO: 796480 - DNA, 10 bp, Artificial Sequence
  misc_feature: Description of Artificial Sequence: Synthetic T6.54 oligonucleotide
agctatcgcg

SEQ ID NO: 796481 - DNA, 10 bp, Artificial Sequence
  misc_feature: Description of Artificial Sequence: Synthetic T6.55 oligonucleotide
agtctgactg

SEQ ID NO: 796482 - DNA, 10 bp, Artificial Sequence
  misc_feature: Description of Artificial Sequence: Synthetic T6.56 oligonucleotide
agtgagctcg

SEQ ID NO: 796483 - DNA, 10 bp, Artificial Sequence
  misc_feature: Description of Artificial Sequence: Synthetic T6.57 oligonucleotide
atagctctcg

SEQ ID NO: 796484 - DNA, 10 bp, Artificial Sequence
  misc_feature: Description of Artificial Sequence: Synthetic T6.58 oligonucleotide
atcacgtgcg

SEQ ID NO: 796485 - DNA, 10 bp, Artificial Sequence
  misc_feature: Description of Artificial Sequence: Synthetic T6.59 oligonucleotide
atcgtagcag

SEQ ID NO: 796486 - DNA, 10 bp, Artificial Sequence
  misc_feature: Description of Artificial Sequence: Synthetic T6.60 oligonucleotide
atcgtctgtg

SEQ ID NO: 796487 - DNA, 10 bp, Artificial Sequence
  misc_feature: Description of Artificial Sequence: Synthetic T6.61 oligonucleotide
atgtacgatg

SEQ ID NO: 796488 - DNA, 10 bp, Artificial Sequence
  misc_feature: Description of Artificial Sequence: Synthetic T6.62 oligonucleotide
atgtgtctag

SEQ ID NO: 796489 - DNA, 10 bp, Artificial Sequence
  misc_feature: Description of Artificial Sequence: Synthetic T6.63 oligonucleotide
cacacgatag

SEQ ID NO: 796490 - DNA, 10 bp, Artificial Sequence
  misc_feature: Description of Artificial Sequence: Synthetic T6.64 oligonucleotide
cactcgcacg

SEQ ID NO: 796491 - DNA, 10 bp, Artificial Sequence
  misc_feature: Description of Artificial Sequence: Synthetic T6.65 oligonucleotide
cagacgtctg

SEQ ID NO: 796492 - DNA, 10 bp, Artificial Sequence
  misc_feature: Description of Artificial Sequence: Synthetic T6.66 oligonucleotide
cagtactgcg

SEQ ID NO: 796493 - DNA, 10 bp, Artificial Sequence
  misc_feature: Description of Artificial Sequence: Synthetic T6.67 oligonucleotide
cgacagcgag

SEQ ID NO: 796494 - DNA, 10 bp, Artificial Sequence
  misc_feature: Description of Artificial Sequence: Synthetic T6.68 oligonucleotide
cgatctgtcg

SEQ ID NO: 796495 - DNA, 10 bp, Artificial Sequence
  misc_feature: Description of Artificial Sequence: Synthetic T6.69 oligonucleotide
cgcgtgctag

SEQ ID NO: 796496 - DNA, 10 bp, Artificial Sequence
  misc_feature: Description of Artificial Sequence: Synthetic T6.70 oligonucleotide
cgctcgagtg

SEQ ID NO: 796497 - DNA, 10 bp, Artificial Sequence
  misc_feature: Description of Artificial Sequence: Synthetic T6.71 oligonucleotide
cgtgatgacg

SEQ ID NO: 796498 - DNA, 10 bp, Artificial Sequence
  misc_feature: Description of Artificial Sequence: Synthetic T6.72 oligonucleotide
ctatgtacag

SEQ ID NO: 796499 - DNA, 10 bp, Artificial Sequence
  misc_feature: Description of Artificial Sequence: Synthetic T6.73 oligonucleotide
ctcgatatag

SEQ ID NO: 796500 - DNA, 10 bp, Artificial Sequence
  misc_feature: Description of Artificial Sequence: Synthetic T6.74 oligonucleotide
ctcgcacgcg

SEQ ID NO: 796501 - DNA, 10 bp, Artificial Sequence
  misc_feature: Description of Artificial Sequence: Synthetic T6.75 oligonucleotide
ctgcgtcacg

SEQ ID NO: 796502 - DNA, 10 bp, Artificial Sequence
  misc_feature: Description of Artificial Sequence: Synthetic T6.76 oligonucleotide
ctgtgcgtcg

SEQ ID NO: 796503 - DNA, 10 bp, Artificial Sequence
  misc_feature: Description of Artificial Sequence: Synthetic T6.77 oligonucleotide
tagcatactg

SEQ ID NO: 796504 - DNA, 10 bp, Artificial Sequence
  misc_feature: Description of Artificial Sequence: Synthetic T6.78 oligonucleotide
tatacatgtg

SEQ ID NO: 796505 - DNA, 10 bp, Artificial Sequence
  misc_feature: Description of Artificial Sequence: Synthetic T6.79 oligonucleotide
tatcactcag

SEQ ID NO: 796506 - DNA, 10 bp, Artificial Sequence
  misc_feature: Description of Artificial Sequence: Synthetic T6.80 oligonucleotide
tatctgatag

SEQ ID NO: 796507 - DNA, 10 bp, Artificial Sequence
  misc_feature: Description of Artificial Sequence: Synthetic T6.81 oligonucleotide
tcgtgacatg

SEQ ID NO: 796508 - DNA, 10 bp, Artificial Sequence
  misc_feature: Description of Artificial Sequence: Synthetic T6.82 oligonucleotide
tctgatcgag

SEQ ID NO: 796509 - DNA, 10 bp, Artificial Sequence
  misc_feature: Description of Artificial Sequence: Synthetic T6.83 oligonucleotide
tgacatctcg

SEQ ID NO: 796510 - DNA, 10 bp, Artificial Sequence
  misc_feature: Description of Artificial Sequence: Synthetic T6.84 oligonucleotide
tgagctagag

SEQ ID NO: 796511 - DNA, 10 bp, Artificial Sequence
  misc_feature: Description of Artificial Sequence: Synthetic T6.85 oligonucleotide
tgatagagcg

SEQ ID NO: 796512 - DNA, 10 bp, Artificial Sequence
  misc_feature: Description of Artificial Sequence: Synthetic T6.86 oligonucleotide
tgcgtgtgcg

SEQ ID NO: 796513 - DNA, 10 bp, Artificial Sequence
  misc_feature: Description of Artificial Sequence: Synthetic T6.87 oligonucleotide
tgctagtcag

SEQ ID NO: 796514 - DNA, 10 bp, Artificial Sequence
  misc_feature: Description of Artificial Sequence: Synthetic T6.88 oligonucleotide
tgtatcacag

SEQ ID NO: 796515 - DNA, 10 bp, Artificial Sequence
  misc_feature: Description of Artificial Sequence: Synthetic T6.89 oligonucleotide
tgtgcgcgtg

SEQ ID NO: 796516 - DNA, 10 bp, Artificial Sequence
  misc_feature: Description of Artificial Sequence: Synthetic T7.1 oligonucleotide
acgagtgcgt

SEQ ID NO: 796517 - DNA, 10 bp, Artificial Sequence
  misc_feature: Description of Artificial Sequence: Synthetic T7.2 oligonucleotide
tagactgcac

SEQ ID NO: 796518 - DNA, 10 bp, Artificial Sequence
  misc_feature: Description of Artificial Sequence: Synthetic T7.3 oligonucleotide
tagcgcgcgc

SEQ ID NO: 796519 - DNA, 10 bp, Artificial Sequence
  misc_feature: Description of Artificial Sequence: Synthetic T7.4 oligonucleotide
tcatcgagtc

SEQ ID NO: 796520 - DNA, 10 bp, Artificial Sequence
  misc_feature: Description of Artificial Sequence: Synthetic T7.5 oligonucleotide
tcgcagacac

SEQ ID NO: 796521 - DNA, 10 bp, Artificial Sequence
  misc_feature: Description of Artificial Sequence: Synthetic T7.6 oligonucleotide
tctgtctcgc

SEQ ID NO: 796522 - DNA, 10 bp, Artificial Sequence
  misc_feature: Description of Artificial Sequence: Synthetic T7.7 oligonucleotide
tgatacgtct

SEQ ID NO: 796523 - DNA, 10 bp, Artificial Sequence
  misc_feature: Description of Artificial Sequence: Synthetic T7.8 oligonucleotide
tgagtgacgc

SEQ ID NO: 796524 - DNA, 10 bp, Artificial Sequence
  misc_feature: Description of Artificial Sequence: Synthetic T7.9 oligonucleotide
tgctcgctac

SEQ ID NO: 796525 - DNA, 10 bp, Artificial Sequence
  misc_feature: Description of Artificial Sequence: Synthetic T7.10 oligonucleotide
acgtgcagcg

SEQ ID NO: 796526 - DNA, 10 bp, Artificial Sequence
  misc_feature: Description of Artificial Sequence: Synthetic T7.11 oligonucleotide
actcacagag

SEQ ID NO: 796527 - DNA, 10 bp, Artificial Sequence
  misc_feature: Description of Artificial Sequence: Synthetic T7.12 oligonucleotide
agactcagcg

SEQ ID NO: 796528 - DNA, 10 bp, Artificial Sequence
  misc_feature: Description of Artificial Sequence: Synthetic T7.13 oligonucleotide
agctatcgcg

SEQ ID NO: 796529 - DNA, 10 bp, Artificial Sequence
  misc_feature: Description of Artificial Sequence: Synthetic T7.14 oligonucleotide
agtctgactg

SEQ ID NO: 796530 - DNA, 10 bp, Artificial Sequence
  misc_feature: Description of Artificial Sequence: Synthetic T7.15 oligonucleotide
atagctctcg

SEQ ID NO: 796531 - DNA, 10 bp, Artificial Sequence
  misc_feature: Description of Artificial Sequence: Synthetic T7.16 oligonucleotide
catagtagtg

SEQ ID NO: 796532 - DNA, 10 bp, Artificial Sequence
  misc_feature: Description of Artificial Sequence: Synthetic T7.17 oligonucleotide
cgatctgtcg

SEQ ID NO: 796533 - DNA, 10 bp, Artificial Sequence
  misc_feature: Description of Artificial Sequence: Synthetic T7.18 oligonucleotide
cgcgtgctag

SEQ ID NO: 796534 - DNA, 10 bp, Artificial Sequence
  misc_feature: Description of Artificial Sequence: Synthetic T7.19 oligonucleotide
cgctcgagtg

SEQ ID NO: 796535 - DNA, 10 bp, Artificial Sequence
  misc_feature: Description of Artificial Sequence: Synthetic T7.20 oligonucleotide
cgagagatac

SEQ ID NO: 796536 - DNA, 10 bp, Artificial Sequence
  misc_feature: Description of Artificial Sequence: Synthetic T7.21 oligonucleotide
tgagctagag

SEQ ID NO: 796537 - DNA, 10 bp, Artificial Sequence
  misc_feature: Description of Artificial Sequence: Synthetic T7.22 oligonucleotide
atacgacgta

SEQ ID NO: 796538 - DNA, 10 bp, Artificial Sequence
  misc_feature: Description of Artificial Sequence: Synthetic T7.23 oligonucleotide
tgcgtgtgcg

SEQ ID NO: 796539 - DNA, 10 bp, Artificial Sequence
  misc_feature: Description of Artificial Sequence: Synthetic T7.24 oligonucleotide
tgctagtcag

SEQ ID NO: 796540 - DNA, 10 bp, Artificial Sequence
  misc_feature: Description of Artificial Sequence: Synthetic T7.25 oligonucleotide
tgtatcacag

SEQ ID NO: 796541 - DNA, 10 bp, Artificial Sequence
  misc_feature: Description of Artificial Sequence: Synthetic T7.26 oligonucleotide
tgtgcgcgtg

SEQ ID NO: 796542 - DNA, 10 bp, Artificial Sequence
  misc_feature: Description of Artificial Sequence: Synthetic T7.27 oligonucleotide
tcacgtacta

SEQ ID NO: 796543 - DNA, 10 bp, Artificial Sequence
  misc_feature: Description of Artificial Sequence: Synthetic T7.28 oligonucleotide
cgtctagtac

SEQ ID NO: 796544 - DNA, 10 bp, Artificial Sequence
  misc_feature: Description of Artificial Sequence: Synthetic T7.29 oligonucleotide
tctacgtagc

SEQ ID NO: 796545 - DNA, 10 bp, Artificial Sequence
  misc_feature: Description of Artificial Sequence: Synthetic T7.30 oligonucleotide
tgtactactc

SEQ ID NO: 796546 - DNA, 10 bp, Artificial Sequence
  misc_feature: Description of Artificial Sequence: Synthetic T7.31 oligonucleotide
acgctcgaca

SEQ ID NO: 796547 - DNA, 10 bp, Artificial Sequence
  misc_feature: Description of Artificial Sequence: Synthetic T7.32 oligonucleotide
acgactacag

SEQ ID NO: 796548 - DNA, 10 bp, Artificial Sequence
  misc_feature: Description of Artificial Sequence: Synthetic T7.33 oligonucleotide
cgtagactag

SEQ ID NO: 796549 - DNA, 10 bp, Artificial Sequence
  misc_feature: Description of Artificial Sequence: Synthetic T7.34 oligonucleotide
tactctcgtg

SEQ ID NO: 796550 - DNA, 10 bp, Artificial Sequence
  misc_feature: Description of Artificial Sequence: Synthetic T7.35 oligonucleotide
tagagacgag

SEQ ID NO: 796551 - DNA, 10 bp, Artificial Sequence
  misc_feature: Description of Artificial Sequence: Synthetic T7.36 oligonucleotide
tcgtcgctcg

SEQ ID NO: 796552 - DNA, 10 bp, Artificial Sequence
  misc_feature: Description of Artificial Sequence: Synthetic T7.37 oligonucleotide
acatacgcgt

SEQ ID NO: 796553 - DNA, 10 bp, Artificial Sequence
  misc_feature: Description of Artificial Sequence: Synthetic T7.38 oligonucleotide
acgcgagtat

SEQ ID NO: 796554 - DNA, 10 bp, Artificial Sequence
  misc_feature: Description of Artificial Sequence: Synthetic T7.39 oligonucleotide
actgtacagt

SEQ ID NO: 796555 - DNA, 10 bp, Artificial Sequence
  misc_feature: Description of Artificial Sequence: Synthetic T7.40 oligonucleotide
agacgcactc

SEQ ID NO: 796556 - DNA, 10 bp, Artificial Sequence
  misc_feature: Description of Artificial Sequence: Synthetic T7.41 oligonucleotide
agactatact

SEQ ID NO: 796557 - DNA, 10 bp, Artificial Sequence
  misc_feature: Description of Artificial Sequence: Synthetic T7.42 oligonucleotide
agcgtcgtct

SEQ ID NO: 796558 - DNA, 10 bp, Artificial Sequence
  misc_feature: Description of Artificial Sequence: Synthetic T7.43 oligonucleotide
agtacgctat

SEQ ID NO: 796559 - DNA, 10 bp, Artificial Sequence
  misc_feature: Description of Artificial Sequence: Synthetic T7.44 oligonucleotide
atagagtact

SEQ ID NO: 796560 - DNA, 10 bp, Artificial Sequence
  misc_feature: Description of Artificial Sequence: Synthetic T7.45 oligonucleotide
cacgctacgt

SEQ ID NO: 796561 - DNA, 10 bp, Artificial Sequence
  misc_feature: Description of Artificial Sequence: Synthetic T7.46 oligonucleotide
cagtagacgt

SEQ ID NO: 796562 - DNA, 10 bp, Artificial Sequence
  misc_feature: Description of Artificial Sequence: Synthetic T7.47 oligonucleotide
cgacgtgact

SEQ ID NO: 796563 - DNA, 10 bp, Artificial Sequence
  misc_feature: Description of Artificial Sequence: Synthetic T7.48 oligonucleotide
agcactgtag

SEQ ID NO: 796564 - DNA, 10 bp, Artificial Sequence
  misc_feature: Description of Artificial Sequence: Synthetic T7.49 oligonucleotide
tacgctgtct

SEQ ID NO: 796565 - DNA, 10 bp, Artificial Sequence
  misc_feature: Description of Artificial Sequence: Synthetic T7.50 oligonucleotide
tcgatcacgt

SEQ ID NO: 796566 - DNA, 10 bp, Artificial Sequence
  misc_feature: Description of Artificial Sequence: Synthetic T7.51 oligonucleotide
tcgcactagt

SEQ ID NO: 796567 - DNA, 10 bp, Artificial Sequence
  misc_feature: Description of Artificial Sequence: Synthetic T7.52 oligonucleotide
tctatactat

SEQ ID NO: 796568 - DNA, 10 bp, Artificial Sequence
  misc_feature: Description of Artificial Sequence: Synthetic T7.53 oligonucleotide
atcagacacg

SEQ ID NO: 796569 - DNA, 10 bp, Artificial Sequence
  misc_feature: Description of Artificial Sequence: Synthetic T7.54 oligonucleotide
agtcgagaga

SEQ ID NO: 796570 - DNA, 10 bp, Artificial Sequence
  misc_feature: Description of Artificial Sequence: Synthetic T7.55 oligonucleotide
cgtacagtca

SEQ ID NO: 796571 - DNA, 10 bp, Artificial Sequence
  misc_feature: Description of Artificial Sequence: Synthetic T7.56 oligonucleotide
cgtactcaga

SEQ ID NO: 796572 - DNA, 10 bp, Artificial Sequence
  misc_feature: Description of Artificial Sequence: Synthetic T7.57 oligonucleotide
atatcgcgag

SEQ ID NO: 796573 - DNA, 10 bp, Artificial Sequence
  misc_feature: Description of Artificial Sequence: Synthetic T7.58 oligonucleotide
ctatagcgta

SEQ ID NO: 796574 - DNA, 10 bp, Artificial Sequence
  misc_feature: Description of Artificial Sequence: Synthetic T7.59 oligonucleotide
tatatataca

SEQ ID NO: 796575 - DNA, 10 bp, Artificial Sequence
  misc_feature: Description of Artificial Sequence: Synthetic T7.60 oligonucleotide
cgtgtctcta

SEQ ID NO: 796576 - DNA, 10 bp, Artificial Sequence
  misc_feature: Description of Artificial Sequence: Synthetic T7.61 oligonucleotide
acagtcgtgc

SEQ ID NO: 796577 - DNA, 10 bp, Artificial Sequence
  misc_feature: Description of Artificial Sequence: Synthetic T7.62 oligonucleotide
ctcgcgtgtc

SEQ ID NO: 796578 - DNA, 10 bp, Artificial Sequence
  misc_feature: Description of Artificial Sequence: Synthetic T7.63 oligonucleotide
agtgacacac

SEQ ID NO: 796579 - DNA, 10 bp, Artificial Sequence
  misc_feature: Description of Artificial Sequence: Synthetic T7.64 oligonucleotide
atatagtcgc

SEQ ID NO: 796580 - DNA, 10 bp, Artificial Sequence
  misc_feature: Description of Artificial Sequence: Synthetic T7.65 oligonucleotide
cacgtagatc

SEQ ID NO: 796581 - DNA, 10 bp, Artificial Sequence
  misc_feature: Description of Artificial Sequence: Synthetic T7.66 oligonucleotide
cgacactatc

SEQ ID NO: 796582 - DNA, 10 bp, Artificial Sequence
  misc_feature: Description of Artificial Sequence: Synthetic T7.67 oligonucleotide
ctgtacatac

SEQ ID NO: 796583 - DNA, 124 bp, Artificial Sequence
  misc_feature: Description of Artificial Sequence: Synthetic Sample-ID_adaptor polynucleotide
  modified_base (22)..(121): a, c, t, g, unknown or other and this region may encompass 2-100 nucleotides
cacgaccggtgctcgatttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggg

SEQ ID NO: 796584 - DNA, 159 bp, Artificial Sequence
  misc_feature: Description of Artificial Sequence: Synthetic FW_long_primer1 polynucleotide
  modified_base (39)..(138): a, c, t, g, unknown or other and this region may encompass 2-100 nucleotides
gagagactgacagcgtatcgcctccctcgcgccatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgaccggtgctcgatttag

SEQ ID NO: 796585 - DNA, 148 bp, Artificial Sequence
  misc_feature: Description of Artificial Sequence: Synthetic kappa_GSP_long_primer2 polynucleotide
  modified_base (26)..(125): a, c, t, g, unknown or other and this region may encompass 2-100 nucleotides
ctatgcgccttgccagcccgctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagatggcgggaagatgaagac

SEQ ID NO: 796586 - DNA, 148 bp, Artificial Sequence
  misc_feature: Description of Artificial Sequence: Synthetic lambda_GSP_long_primer2 polynucleotide
  modified_base (26)..(125): a, c, t, g, unknown or other and this region may encompass 2-100 nucleotides
ctatgcgccttgccagcccgctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggagggygggaacagagtgac

SEQ ID NO: 796587 - DNA, 148 bp, Artificial Sequence
  misc_feature: Description of Artificial Sequence: Synthetic gamma_GSP_long_primer2 polynucleotide
  modified_base (26)..(125): a, c, t, g, unknown or other and this region may encompass 2-100 nucleotides
ctatgcgccttgccagcccgctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagtagtccttgaccaggcag

SEQ ID NO: 796588 - DNA, 112 bp, Artificial Sequence
  misc_feature: Description of Artificial Sequence: Synthetic Clon_PacI polynucleotide
  modified_base (13)..(112): a, c, t, g, unknown or other and this region may encompass 2-100 nucleotides
actgttaattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 796589 - DNA, 112 bp, Artificial Sequence
  misc_feature: Description of Artificial Sequence: Synthetic Clon_AscI polynucleotide
  modified_base (13)..(112): a, c, t, g, unknown or other and this region may encompass 2-100 nucleotides
attaggcgcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 796590 - DNA, 112 bp, Artificial Sequence
  misc_feature: Description of Artificial Sequence: Synthetic Clon_FseI polynucleotide
  modified_base (13)..(112): a, c, t, g, unknown or other and this region may encompass 2-100 nucleotides
attaggccggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 796591 - DNA, 112 bp, Artificial Sequence
  misc_feature: Description of Artificial Sequence: Synthetic Clon_AsiSI polynucleotide
  modified_base (13)..(112): a, c, t, g, unknown or other and this region may encompass 2-100 nucleotides
attagcgatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 796592 - RNA, 3 nt, Artificial Sequence
  misc_feature: Description of Artificial Sequence: Synthetic Adaptor_v3 oligonucleotide
ggg

SEQ ID NO: 796593 - DNA, 21 bp, Artificial Sequence
  synthetic polynucleotide sequence
cacgaccggtgctcgatttag

SEQ ID NO: 796594 - DNA, 38 bp, Artificial sequence
  synthetic polynucleotide sequence
gagagactgacagcgtatcgcctccctcgcgccatcag

SEQ ID NO: 796595 - DNA, 25 bp, Artificial sequence
  synthetic polynucleotide sequence
ctatgcgccttgccagcccgctcag

SEQ ID NO: 796596 - DNA, 19 bp, Artificial sequence
  synthetic polynucleotide sequence
atggttcacacccatgacg

SEQ ID NO: 796597 - DNA, 21 bp, Artificial sequence
  synthetic polynucleotide sequence
  misc_feature (19)..(19): n may be any number of a,t,c,g nucleotides
cacgaccggtgctcgattnag

SEQ ID NO: 796598 - DNA, 23 bp, Artificial sequence
  synthetic polynucleotide sequence
  misc_feature (23)..(23): n may be any number of a,t,c,g nucleotides
acgtctcatcaaggaaggaaggn

SEQ ID NO: 796599 - DNA, 20 bp, Artificial sequence
  synthetic polynucleotide sequence
  misc_feature (14)..(14): n may be any number of a,t,c,g nucleotides
  misc_feature (17)..(17): n may be any number of a,t,c,g nucleotides
  misc_feature (20)..(20): n may be any number of a,t,c,g nucleotides
actcatctacaggnaanggn

SEQ ID NO: 796600 - DNA, 21 bp, Artificial sequence
  synthetic polynucleotide sequence
  misc_feature (21)..(21): n may be any number of a,t,c,g nucleotides
agagcgtcacagagagaaggn

SEQ ID NO: 796601 - DNA, 22 bp, Artificial sequence
  synthetic polynucleotide sequence
  misc_feature (22)..(22): n may be any number of a,t,c,g nucleotides
atctactgacaacacacaaggn

SEQ ID NO: 796602 - DNA, 23 bp, Artificial sequence
  synthetic polynucleotide sequence
  misc_feature (20)..(20): n may be any number of a,t,c,g nucleotides
  misc_feature (23)..(23): n may be any number of a,t,c,g nucleotides
catactctacaacacacaanggn

SEQ ID NO: 796603 - DNA, 21 bp, Artificial sequence
  synthetic polynucleotide sequence
  misc_feature (15)..(15): n may be any number of a,t,c,g nucleotides
  misc_feature (18)..(18): n may be any number of a,t,c,g nucleotides
  misc_feature (21)..(21): n may be any number of a,t,c,g nucleotides
ctacgactgcaaggnaanggn

SEQ ID NO: 796604 - DNA, 21 bp, Artificial sequence
  synthetic polynucleotide sequence
  misc_feature (12)..(12): n may be any number of a,t,c,g nucleotides
  misc_feature (15)..(15): n may be any number of a,t,c,g nucleotides
  misc_feature (18)..(18): n may be any number of a,t,c,g nucleotides
  misc_feature (21)..(21): n may be any number of a,t,c,g nucleotides
tagtgtagattnggnttnggn

SEQ ID NO: 796605 - DNA, 17 bp, Artificial sequence
  synthetic polynucleotide sequence
  misc_feature (17)..(17): n may be any number of a,t,c,g nucleotides
tagtgtagattcgcggn

SEQ ID NO: 796606 - DNA, 21 bp, Artificial sequence
  synthetic polynucleotide sequence
  misc_feature (12)..(12): n may be any number of a,t,c,g nucleotides
  misc_feature (15)..(15): n may be any number of a,t,c,g nucleotides
  misc_feature (18)..(18): n may be any number of a,t,c,g nucleotides
  misc_feature (21)..(21): n may be any number of a,t,c,g nucleotides
tctagcgacttnggnttnggn

SEQ ID NO: 796607 - DNA, 21 bp, Artificial sequence
  synthetic polynucleotide sequence
  misc_feature (12)..(12): n may be any number of a,t,c,g nucleotides
  misc_feature (15)..(15): n may be any number of a,t,c,g nucleotides
  misc_feature (18)..(18): n may be any number of a,t,c,g nucleotides
  misc_feature (21)..(21): n may be any number of a,t,c,g nucleotides
tgtgagtagttnggnttnggn

SEQ ID NO: 796608 - DNA, 21 bp, Artificial sequence
  synthetic polynucleotide sequence
  misc_feature (15)..(15): n may be any number of a,t,c,g nucleotides
  misc_feature (18)..(18): n may be any number of a,t,c,g nucleotides
  misc_feature (21)..(21): n may be any number of a,t,c,g nucleotides
agctcacgtattggnttnggn

SEQ ID NO: 796609 - DNA, 20 bp, Artificial sequence
  synthetic polynucleotide sequence
  misc_feature (14)..(14): n may be any number of a,t,c,g nucleotides
  misc_feature (17)..(17): n may be any number of a,t,c,g nucleotides
  misc_feature (20)..(20): n may be any number of a,t,c,g nucleotides
tcgatagtgaaggnaanggn

SEQ ID NO: 796610 - DNA, 22 bp, Artificial sequence
  synthetic polynucleotide sequence
  misc_feature (12)..(12): n may be any number of a,t,c,g nucleotides
  misc_feature (19)..(19): n may be any number of a,t,c,g nucleotides
  misc_feature (22)..(22): n may be any number of a,t,c,g nucleotides
tcgctgcgtaanggagaanggn

SEQ ID NO: 796611 - DNA, 20 bp, Artificial sequence
  synthetic polynucleotide sequence
  misc_feature (13)..(13): n may be any number of a,t,c,g nucleotides
  misc_feature (14)..(14): n is a, c, g, or t
  misc_feature (17)..(17): n may be any number of a,t,c,g nucleotides
  misc_feature (20)..(20): n may be any number of a,t,c,g nucleotides
tgagtcagtaaggnaanggn

SEQ ID NO: 796612 - DNA, 20 bp, Artificial sequence
  synthetic polynucleotide sequence
  misc_feature (13)..(13): n may be any number of a,t,c,g nucleotides
  misc_feature (14)..(14): n is a, c, g, or t
  misc_feature (17)..(17): n may be any number of a,t,c,g nucleotides
  misc_feature (20)..(20): n may be any number of a,t,c,g nucleotides
tgtagtgtgaaggnaanggn

SEQ ID NO: 796613 - DNA, 20 bp, Artificial sequence
  synthetic polynucleotide sequence
  misc_feature (20)..(20): n may be any number of a,t,c,g nucleotides
tgtcgtcgcaagagagaggn

SEQ ID NO: 796614 - DNA, 23 bp, Artificial sequence
  synthetic polynucleotide sequence
  misc_feature (20)..(20): n may be any number of a,t,c,g nucleotides
  misc_feature (23)..(23): n may be any number of a,t,c,g nucleotides
tatagacatcaacacacaanggn

SEQ ID NO: 796615 - DNA, 21 bp, Artificial sequence
  synthetic polynucleotide sequence
  misc_feature (15)..(15): n may be any number of a,t,c,g nucleotides
  misc_feature (18)..(18): n may be any number of a,t,c,g nucleotides
  misc_feature (21)..(21): n may be any number of a,t,c,g nucleotides
tcacgcgagaaaggnaanggn

SEQ ID NO: 796616 - DNA, 17 bp, Artificial sequence
  synthetic polynucleotide sequence
  misc_feature (17)..(17): n may be any number of a,t,c,g nucleotides
tcgagctctctcgcggn

SEQ ID NO: 796617 - DNA, 17 bp, Artificial sequence
  synthetic polynucleotide sequence
  misc_feature (17)..(17): n may be any number of a,t,c,g nucleotides
cagacgtctgtcgcggn

SEQ ID NO: 796618 - DNA, 20 bp, Artificial sequence
  synthetic polynucleotide sequence
  misc_feature (14)..(14): n may be any number of a,t,c,g nucleotides
  misc_feature (17)..(17): n may be any number of a,t,c,g nucleotides
  misc_feature (20)..(20): n may be any number of a,t,c,g nucleotides
ctacgctctaaggnaanggn

SEQ ID NO: 796619 - DNA, 43 bp, Artificial sequence
  synthetic polynucleotide sequence
  misc_feature (30)..(30): n may be any number of a,t,c,g nucleotides
cacgaccggtgctcgatttagttaattaanagcgatcgctggg

SEQ ID NO: 796620 - DNA, 25 bp, Artificial sequence
  synthetic polynucleotide sequence
ctaaatcgagcaccggtcgtgtggg

SEQ ID NO: 796621 - DNA, 46 bp, Artificial sequence
  synthetic polynucleotide sequence
  misc_feature (33)..(33): n may be any number of a,t,c,g nucleotides
cgtatcgctcctaggagcgatacgttaattaanagcgatcgctggg

SEQ ID NO: 796622 - DNA, 25 bp, Artificial sequence
  synthetic polynucleotide sequence
atgaggstcccygctcagctgctgg

SEQ ID NO: 796623 - DNA, 23 bp, Artificial sequence
  synthetic polynucleotide sequence
ggtcctgggcccagtctgccctg

SEQ ID NO: 796624 - DNA, 52 bp, Artificial sequence
  synthetic polynucleotide sequence
aggcccttacgactgcgtcttgaacaataccagatggcgggaagatgaagac

SEQ ID NO: 796625 - DNA, 48 bp, Artificial sequence
  synthetic polynucleotide sequence
aggcccttacgactgcgtcttgaacaatacctcccgggtagaagtcac

SEQ ID NO: 796626 - DNA, 22 bp, Artificial sequence
  synthetic polynucleotide sequence
aggcccttacgactgcgtcttg

SEQ ID NO: 796627 - DNA, 162 bp, Artificial sequence
  synthetic polynucleotide sequence
gctcgatttagagagtgatcgttgggattggtgcagccacagttcgtttgatctccaccttggtccctcggccgaacgtgagccggcacctgtccggtgcagccacagttcgtttaatctccagtcgtgtcccttggccgaaggagggccagttgctacggt

SEQ ID NO: 796628 - protein, 20 aa, Artificial Sequence
  synthetic polypeptide sequence
SCVFSGFTFRVYDMHWVRQA

SEQ ID NO: 796629 - protein, 20 aa, Artificial Sequence
  synthetic polypeptide sequence
SCAASGFTFRVYDMHWVRQA

SEQ ID NO: 796630 - protein, 20 aa, Artificial Sequence
  synthetic polypeptide sequence
SCVVSGFTFRVYDMHWVRQA

SEQ ID NO: 796631 - protein, 20 aa, Artificial Sequence
  synthetic polypeptide sequence
  MISC_FEATURE (4)..(4): x can be any amino acid
SCVXSGFTFRVYDMHWVRQA

SEQ ID NO: 796632 - protein, 20 aa, Artificial Sequence
  synthetic polypeptide sequence
VAVISYDGSNKYYADSVKGR

SEQ ID NO: 796633 - protein, 20 aa, Artificial Sequence
  synthetic polypeptide sequence
VAVISYDGSNIYYVDSVKGR

SEQ ID NO: 796634 - protein, 20 aa, Artificial Sequence
  synthetic polypeptide sequence
VAFISHDGSKTYYAESVKGR

SEQ ID NO: 796635 - protein, 20 aa, Artificial Sequence
  synthetic polypeptide sequence
  MISC_FEATURE (11)..(11): x can be any amino acid
VAVISYDGSNXYYADSVKGR

SEQ ID NO: 796636 - protein, 23 aa, Artificial Sequence
  synthetic polypeptide sequence
CANLITEDNGNPRPHGTDVWGQG

SEQ ID NO: 796637 - protein, 23 aa, Artificial Sequence
  synthetic polypeptide sequence
CANLITEDNGDPRPLGAEVWGQG

SEQ ID NO: 796638 - protein, 23 aa, Artificial Sequence
  synthetic polypeptide sequence
CANLITEDNGNPVRSVRTSWGQG

SEQ ID NO: 796639 - protein, 23 aa, Artificial Sequence
  synthetic polypeptide sequence
  MISC_FEATURE (15)..(15): x can be any amino acid
  MISC_FEATURE (17)..(18): x can be any amino acid
CANLITEDNGNPRPXGXXVWGQG

SEQ ID NO: 796640 - protein, 20 aa, Artificial Sequence
  synthetic polypeptide sequence
ITCQASQDISNYLNWYQQKP

SEQ ID NO: 796641 - protein, 20 aa, Artificial Sequence
  synthetic polypeptide sequence
ITCRASQDISMYLNWYQQKP

SEQ ID NO: 796642 - protein, 20 aa, Artificial Sequence
  synthetic polypeptide sequence
ITCQASEDISNYLNWYQQKP

SEQ ID NO: 796643 - protein, 20 aa, Artificial Sequence
  synthetic polypeptide sequence
ITCQASQDISNYLNWYQQKP

SEQ ID NO: 796644 - protein, 15 aa, Artificial Sequence
  synthetic polypeptide sequence
KLLIYDASNLETGVP

SEQ ID NO: 796645 - protein, 15 aa, Artificial Sequence
  synthetic polypeptide sequence
KLLILDASTLETGVP

SEQ ID NO: 796646 - protein, 15 aa, Artificial Sequence
  synthetic polypeptide sequence
KLLIYDASNLETGVP

SEQ ID NO: 796647 - protein, 15 aa, Artificial Sequence
  synthetic polypeptide sequence
KLLIYDASNLETGVP

SEQ ID NO: 796648 - protein, 14 aa, Artificial Sequence
  synthetic polypeptide sequence
CQQYDNLPLTFGGG

SEQ ID NO: 796649 - protein, 14 aa, Artificial Sequence
  synthetic polypeptide sequence
CQQYDSLPLTFGGG

SEQ ID NO: 796650 - protein, 14 aa, Artificial Sequence
  synthetic polypeptide sequence
CQQYDNLPLTFGGG

SEQ ID NO: 796651 - protein, 14 aa, Artificial Sequence
  synthetic polypeptide sequence
CQQYDNLPLTFGGG
